United States Patent 12,569,549 (FLAVIVIRUS VACCINE) - sequence listing, part 25

SEQ ID NO: 10620 - RNA, 9879 nt, synthetic construct
  misc_feature 1..9879: note = derived and/or modified CDS sequence (opt2) from DENV-1__JQ922546__SS-prME
  source 1..9879: mol_type = other RNA
tccgtcgccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtggccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccatcatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccatccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacgtcatgtggaagcagatctccaacgagctcaaccacatcctcctcgagaacgacatgaagttcaccgtcgtcgtcggcgacgtcaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcttccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctctcccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggcctccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcatcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcatcttcaagacccccgagggcgaggtcggcgccatcaccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatgaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggagggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgaccacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtacaccgaccgccgctggtgcttcgacggcgagcgcaacaaccaggtcctcgaggagaacatggacgtcgagatctggatggaggagggcgagaagaagaagatccgcccccgctggctcgagatcgagaagtactccgaccccctcgccctccgcgagttcaaggagttctccgccaagcgcaagtccgtcctcggcgacctcaagctcgagatcggcaagctcccccagcacctcaccatcaaggcccgcaacgccctcgacaacctcgtcatgctccacaactccgagcagggcggcaaggcctaccgccacgccatggaggagctccccgacaccatcgagaccctcatgcgcctcggcctcatcgccgtcatgaccggcggcgtcaccctcttcttcctctccggcaagggcctcggcaagacctccaacggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccccccagatcatgaagaaccagatcgtcgacggcatcgtcgccgtcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccaccgtcacccagatcgccatgaccgacaccacccccttcggccagcagcgcgtcttcaaggagaaggtcgacacccgcacccccaaggccaagcgcggcaccgcccagatcatggaggtcaccgccaactggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcaactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacaccccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccacggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccatcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10621 - RNA, 9879 nt, synthetic construct
  misc_feature 1..9879: note = derived and/or modified CDS sequence (opt2) from DENV-1__JQ922545__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacaccatcggcacctccatcacccagaagggcatcatcttcatcctcctcatgaccggcgcccccatcatggccatgcgctgcgtcggcatcggcaaccgcgacttcgtcgagggcctctccggcgccccctgggtcgacgtcgtcctcgagcacggctcctgcctctccaacatggccaagaacaagcccaccctcgacatcgacttcttcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagatgtccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacctgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatcgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggcccagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggctccgacatcgccaccgtcctcgagcgctcccgcgagcccgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatccccaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcgagaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcatcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagatcggccacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggatgtggggcttcctcttccgcaaccgccccccccgcatctgcacccgcgacgagttcgcccgcaaggtccgctcctccaccgccaacggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgactcctccaacgaggccaagatcatcgagctcatgcgccccgagcacgccctcctcgccacctccatcttcaagctcaccttccagatctccgtcgtccgcgtccagcgccccgccaagtccggcaccgtcatggagtgcatctcccgccgcgaccagaagcgctccggccaggtcggcacctacggcctcaacaccttcaccaacatggaggtccagctcatccgccagatggagtccgagggcatcttctccccctccgagatggagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10622 - RNA, 9879 nt, synthetic construct
  misc_feature 1..9879: note = derived and/or modified CDS sequence (opt2) from DENV-1__GU131887__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatccgctacgagggcaccgacgccccctgcaagatccccttctccacccaggacgagcgcggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccttctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggcgctcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgccctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagatcaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10623 - RNA, 9879 nt, synthetic construct
  misc_feature 1..9879: note = derived and/or modified CDS sequence (opt2) from DENV-1__GU131888__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagtccgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccggctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggccccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccctcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10624 - RNA, 9879 nt, synthetic construct
  misc_feature 1..9879: note = derived and/or modified CDS sequence (opt2) from DENV-1__GU131892__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10625 - RNA, 9879 nt, synthetic construct
  misc_feature 1..9879: note = derived and/or modified CDS sequence (opt2) from DENV-1__GU131893__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatgacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgccacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcctcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgctcccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgtctggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10626 - RNA, 9879 nt, synthetic construct
  misc_feature 1..9879: note = derived and/or modified CDS sequence (opt2) from DENV-1__GU131894__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccacaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggacccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10627 - RNA, 9879 nt, synthetic construct
  misc_feature 1..9879: note = derived and/or modified CDS sequence (opt2) from DENV-1__GU131895__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcgccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccacaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10628 - RNA, 9879 nt, synthetic construct
  misc_feature 1..9879: note = derived and/or modified CDS sequence (opt2) from DENV-1__GQ868632__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgagcagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagcgcgaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccttcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccacaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10629 - RNA, 9879 nt, synthetic construct
  misc_feature 1..9879: note = derived and/or modified CDS sequence (opt2) from DENV-1__GQ868633__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgaggccaccaagcacgccgtctcccgcggccccgccaagctccgctggttcgtcgagcgcaacctcgtcaaccccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccacaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactgggtctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctggtcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10630 - RNA, 9879 nt, synthetic construct
  misc_feature 1..9879: note = derived and/or modified CDS sequence (opt2) from DENV-1__GU131919__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctgcgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10631 - RNA, 9879 nt, synthetic construct
  misc_feature 1..9879: note = derived and/or modified CDS sequence (opt2) from DENV-1__GU131920__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgaccgcgagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccacaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10632 - RNA, 9879 nt, synthetic construct
  misc_feature 1..9879: note = derived and/or modified CDS sequence (opt2) from DENV-1__GU131921__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatggccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccatgaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcgccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagaaggccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10633 - RNA, 9879 nt, synthetic construct
  misc_feature 1..9879: note = derived and/or modified CDS sequence (opt2) from DENV-1__GQ868635__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatggccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcgccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagaaggccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10634 - RNA, 9879 nt, synthetic construct
  misc_feature 1..9879: note = derived and/or modified CDS sequence (opt2) from DENV-1__GQ868636__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggcctcggcgaggtcgactccttctccctcggcctcctctgcatctccatcatgatcgaggaggtcatgcgctcccgctggtcccgcaagatgctcatggccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccaccacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagcgctgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10635 - RNA, 9879 nt, synthetic construct
  misc_feature 1..9879: note = derived and/or modified CDS sequence (opt2) from DENV-1__GU131922__SS-prME
  source 1..9879: mol_type = other RNA
tccgtcatcatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccacaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10636 - RNA, 9879 nt, synthetic construct
  misc_feature 1..9879: note = derived and/or modified CDS sequence (opt2) from DENV-1__GU131923__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccgtcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcatcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggcaagcgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgaggccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10637 - RNA, 9879 nt, synthetic construct
  misc_feature 1..9879: note = derived and/or modified CDS sequence (opt2) from DENV-1__GQ868637__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagcgcgaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcatcgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgacgagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10638 - RNA, 9879 nt, synthetic construct
  misc_feature 1..9879: note = derived and/or modified CDS sequence (opt2) from DENV-1__GQ868639__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatctccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcatgacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcgccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgccgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10639 - RNA, 9879 nt, synthetic construct
  misc_feature 1..9879: note = derived and/or modified CDS sequence (opt2) from DENV-1__GU131925__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10640 - RNA, 9879 nt, synthetic construct
  misc_feature 1..9879: note = derived and/or modified CDS sequence (opt2) from DENV-1__GU131926__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatctccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcgtcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcatgacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgccgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10641 - RNA, 9879 nt, synthetic construct
  misc_feature 1..9879: note = derived and/or modified CDS sequence (opt2) from DENV-1__FJ639669__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10642 - RNA, 9882 nt, synthetic construct
  misc_feature 1..9882: note = derived and/or modified CDS sequence (opt2) from DENV-1__FJ639670__SS-prME
  source 1..9882: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgtctcccgcaagaacctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatcgcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcctccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10643 - RNA, 9879 nt, synthetic construct
  misc_feature 1..9879: note = derived and/or modified CDS sequence (opt2) from DENV-1__FJ639671__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacggcaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacgtcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacctccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactcccgcgccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgagaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10644 - RNA, 9879 nt, synthetic construct
  misc_feature 1..9879: note = derived and/or modified CDS sequence (opt2) from DENV-1__JN819423__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacggcaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacgtcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacctccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactcccgcgccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgagaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccagcagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10645 - RNA, 9879 nt, synthetic construct
  misc_feature 1..9879: note = derived and/or modified CDS sequence (opt2) from DENV-1__FJ639672__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatctcctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgccttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10646 - RNA, 9879 nt, synthetic construct
  misc_feature 1..9879: note = derived and/or modified CDS sequence (opt2) from DENV-1__FJ639673__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10647 - RNA, 9879 nt, synthetic construct
  misc_feature 1..9879: note = derived and/or modified CDS sequence (opt2) from DENV-1__FJ639674__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccatgtccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgtcaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10648 - RNA, 9879 nt, synthetic construct
  misc_feature 1..9879: note = derived and/or modified CDS sequence (opt2) from DENV-1__FJ639675__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggcctcttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctcctccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcatgacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10649 - RNA, 9879 nt, synthetic construct
  misc_feature 1..9879: note = derived and/or modified CDS sequence (opt2) from DENV-1__FJ639676__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgccggcctcggcctcgagacccgcgccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcgtcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcttcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccatctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcctcgaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgacttcatgacctccatgaagcgcttcaagaacgagtccgacaccgagggcgccctctggtga

SEQ ID NO: 10650 - RNA, 9879 nt, synthetic construct
  misc_feature 1..9879: note = derived and/or modified CDS sequence (opt2) from DENV-1__FJ639677__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcgtcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccatgggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctcaagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgctccaagaagccccgcatctgcacccgcgaggagttcatccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10651 - RNA, 9879 nt, synthetic construct
  misc_feature 1..9879: note = derived and/or modified CDS sequence (opt2) from DENV-1__GQ868618__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10652 - RNA, 9879 nt, synthetic construct
  misc_feature 1..9879: note = derived and/or modified CDS sequence (opt2) from DENV-1__GQ868619__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgtcgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccatcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcatgctcttcttcctctccggccgcggcctcggcaagacctccatcggcctcctctgcgtcatggcctcctccggcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatgggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10653 - RNA, 9879 nt, synthetic construct
  misc_feature 1..9879: note = derived and/or modified CDS sequence (opt2) from DENV-1__FJ639678__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaaggccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacgccaccgacacctgggtcacctacggcacctgcccccagaccggcgagcaccgccgcgaccgccgctccgtcgccctcgccccccacgtcggcctcggcctcgagacccgcgccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagtacaagtactcctggaagtcctggggcaaggccaagatcatcggcgccgacatccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcctctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccaggagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagaaggcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcagggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccgcaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10654 - RNA, 9879 nt, synthetic construct
  misc_feature 1..9879: note = derived and/or modified CDS sequence (opt2) from DENV-1__FJ639679__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgcccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10655 - RNA, 9879 nt, synthetic construct
  misc_feature 1..9879: note = derived and/or modified CDS sequence (opt2) from DENV-1__FJ850069__SS-prME
  source 1..9879: mol_type = other RNA
tccgtcaccatgctcctcatgctcatgcccaccgccctcgccttccacctcaccacccgcggcggcgagccccacatgatcgtcggcaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggtcaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcttcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccatctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcctcgaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccggctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgacaccgagggcgccctctggtga

SEQ ID NO: 10656 - RNA, 9879 nt, synthetic construct
  misc_feature 1..9879: note = derived and/or modified CDS sequence (opt2) from DENV-1__FJ639680__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccacaaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10657 - RNA, 9879 nt, synthetic construct
  misc_feature 1..9879: note = derived and/or modified CDS sequence (opt2) from DENV-1__FJ639682__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaagaccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcctctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatccccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10658 - RNA, 9879 nt, synthetic construct
  misc_feature 1..9879: note = derived and/or modified CDS sequence (opt2) from DENV-1__JQ287664__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcttcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgcaagtacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccatctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcctcgaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccttcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgacaccgagggcgccctctggtga

SEQ ID NO: 10659 - RNA, 9879 nt, synthetic construct
  misc_feature 1..9879: note = derived and/or modified CDS sequence (opt2) from DENV-1__FJ639683__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccttctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccctcgtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggccacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10660 - RNA, 9879 nt, synthetic construct
  misc_feature 1..9879: note = derived and/or modified CDS sequence (opt2) from DENV-1__FJ639684__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatctccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcatgacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgtccccgagggcgccctctggtga

SEQ ID NO: 10661 - RNA, 9879 nt, synthetic construct
  misc_feature 1..9879: note = derived and/or modified CDS sequence (opt2) from DENV-1__FJ639685__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccttctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccgtcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccatcctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10662 - RNA, 9879 nt, synthetic construct
  misc_feature 1..9879: note = derived and/or modified CDS sequence (opt2) from DENV-1__FJ639686__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatccgctacgagggcaccgacgccccctgcaagatccccttctccacccaggacgagcgcggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccttctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggcgctcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagatcaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10663 - RNA, 9879 nt, synthetic construct
  misc_feature 1..9879: note = derived and/or modified CDS sequence (opt2) from DENV-1__FJ639687__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatctccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcatgacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgccgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctcaaggagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10664 - RNA, 9879 nt, synthetic construct
  misc_feature 1..9879: note = derived and/or modified CDS sequence (opt2) from DENV-1__FJ639688__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacgtctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccacctccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatggccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatctaccaggtccgccgcctcatcggcaacgagaactacctcgactacatgacctccatgaagcgcttcaagaacgagtccgaccccgagggcgccctctggtga

SEQ ID NO: 10665 - RNA, 9879 nt, synthetic construct
  misc_feature 1..9879: note = derived and/or modified CDS sequence (opt2) from DENV-1__FJ639689__SS-prME
  source 1..9879: mol_type = other RNA
tccgtcaccatgctcctcatgctcatgcccaccgccctcgccttccacctcaccatccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccttctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggcgctcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgaccgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatcctcaagctcctcaccgacttccagccccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcgtcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagatcaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10666 - RNA, 9879 nt, synthetic construct
  misc_feature 1..9879: note = derived and/or modified CDS sequence (opt2) from DENV-1__FJ639690__SS-prME
  source 1..9879: mol_type = other RNA
tccgtcaccatgctcctcatgctcatgcccaccgccctcgccttccacctcaccatccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagatcggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccttctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggcgctcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgaccgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatcctcaagctcctcaccgacttccagccccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagatcaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10667 - RNA, 9879 nt, synthetic construct
  misc_feature 1..9879: note = derived and/or modified CDS sequence (opt2) from DENV-1__FJ639691__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatctccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcatgacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcaccctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgacctcgagggcgccctctggtga

SEQ ID NO: 10668 - RNA, 9879 nt, synthetic construct
  misc_feature 1..9879: note = derived and/or modified CDS sequence (opt2) from DENV-1__FJ639692__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagtccgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccctcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcaccgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10669 - RNA, 9879 nt, synthetic construct
  misc_feature 1..9879: note = derived and/or modified CDS sequence (opt2) from DENV-1__FJ639693__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatctccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcatgacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgccgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccgtcggcttccagaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccggccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10670 - RNA, 9879 nt, synthetic construct
  misc_feature 1..9879: note = derived and/or modified CDS sequence (opt2) from DENV-1__FJ639694__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccttctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggcgctcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagatcaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctccaactggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10671 - RNA, 9879 nt, synthetic construct
  misc_feature 1..9879: note = derived and/or modified CDS sequence (opt2) from DENV-1__FJ639695__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatgacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcctcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgctcccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgtctggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10672 - RNA, 9879 nt, synthetic construct
  misc_feature 1..9879: note = derived and/or modified CDS sequence (opt2) from DENV-1__FJ639696__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatctccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcatgacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgacctcgagggcgccctctggtga

SEQ ID NO: 10673 - RNA, 9879 nt, synthetic construct
  misc_feature 1..9879: note = derived and/or modified CDS sequence (opt2) from DENV-1__HM181937__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccacaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatcgaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10674 - RNA, 9879 nt, synthetic construct
  misc_feature 1..9879: note = derived and/or modified CDS sequence (opt2) from DENV-1__HM181939__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatctccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcatgacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccatcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgacatcatggagcccgagcacgccctcctcgccaactccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10675 - RNA, 9879 nt, synthetic construct
  misc_feature 1..9879: note = derived and/or modified CDS sequence (opt2) from DENV-1__HM181942__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatctccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcatgacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgacatcatggagcccgagcacgccctcctcgccaactccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10676 - RNA, 9879 nt, synthetic construct
  misc_feature 1..9879: note = derived and/or modified CDS sequence (opt2) from DENV-1__HM488255__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagtccgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggccgcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10677 - RNA, 9879 nt, synthetic construct
  misc_feature 1..9879: note = derived and/or modified CDS sequence (opt2) from DENV-1__HM181944__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatctccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcatgacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgacatcatggagcccgagcacgccctcctcgccaactccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10678 - RNA, 9879 nt, synthetic construct
  misc_feature 1..9879: note = derived and/or modified CDS sequence (opt2) from DENV-1__HM181946__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatccgctacgagggcaccgacgccccctgcaagatccccttctccacccaggacgagcgcggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccttctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggcgctcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10679 - RNA, 9879 nt, synthetic construct
  misc_feature 1..9879: note = derived and/or modified CDS sequence (opt2) from DENV-1__HM181948__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10680 - RNA, 9879 nt, synthetic construct
  misc_feature 1..9879: note = derived and/or modified CDS sequence (opt2) from DENV-1__HM181949__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccggccacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggccgcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10681 - RNA, 9879 nt, synthetic construct
  misc_feature 1..9879: note = derived and/or modified CDS sequence (opt2) from DENV-1__HM181950__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcgccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctactccctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10682 - RNA, 9879 nt, synthetic construct
  misc_feature 1..9879: note = derived and/or modified CDS sequence (opt2) from DENV-1__HM181952__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgccaaggcctccttcatcgaggtcaagacctgcatctggcccaagtcccacaccctctggtccaacggcgtcctcgagtccgagatgatcatccccaagatccacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcgtcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctccccaacgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 10683 - RNA, 9879 nt, synthetic construct
  misc_feature 1..9879: note = derived and/or modified CDS sequence (opt2) from DENV-1__HM181953__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagctcgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10684 - RNA, 9879 nt, synthetic construct
  misc_feature 1..9879: note = derived and/or modified CDS sequence (opt2) from DENV-1__KF921933__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactccaagtgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgcctcggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacggccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10685 - RNA, 9879 nt, synthetic construct
  misc_feature 1..9879: note = derived and/or modified CDS sequence (opt2) from DENV-1__HM181954__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacccccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcgccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggcctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10686 - RNA, 9879 nt, synthetic construct
  misc_feature 1..9879: note = derived and/or modified CDS sequence (opt2) from DENV-1__HM181955__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagtccgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgtcgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10687 - RNA, 9879 nt, synthetic construct
  misc_feature 1..9879: note = derived and/or modified CDS sequence (opt2) from DENV-1__HM181959__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagtccgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaaggtcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgtcgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10688 - RNA, 9879 nt, synthetic construct
  misc_feature 1..9879: note = derived and/or modified CDS sequence (opt2) from DENV-1__JF937651__SS-prME
  source 1..9879: mol_type = other RNA
tccgtcaccatgctcctcatgctcatgcccaccgccctcgccttccacctcaccacccgcggcggcgagccccacatgatcctctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctgcgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgaagcacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcaccggcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccaagggcgccctctggtga

SEQ ID NO: 10689 - RNA, 9879 nt, synthetic construct
  misc_feature 1..9879: note = derived and/or modified CDS sequence (opt2) from DENV-1__GU131956__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcaccatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatggtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10690 - RNA, 9879 nt, synthetic construct
  misc_feature 1..9879: note = derived and/or modified CDS sequence (opt2) from DENV-1__GU131958__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10691 - RNA, 9879 nt, synthetic construct
  misc_feature 1..9879: note = derived and/or modified CDS sequence (opt2) from DENV-1__GQ868499__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcggccaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaaggacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccctcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggtcgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10692 - RNA, 9879 nt, synthetic construct
  misc_feature 1..9879: note = derived and/or modified CDS sequence (opt2) from DENV-1__GQ868500__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatggtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcgtcatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcaagcagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcggcgagaaccagtggaactccgccaaggaggccgtcgaggacgagcgcgtctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10693 - RNA, 9879 nt, synthetic construct
  misc_feature 1..9879: note = derived and/or modified CDS sequence (opt2) from DENV-1__GU131961__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttccgcctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgtcctctggtga

SEQ ID NO: 10694 - RNA, 9870 nt, synthetic construct
  misc_feature 1..9870: note = derived and/or modified CDS sequence (opt2) from DENV-1__GU131962__SS-prME
  source 1..9870: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgagtacgcctccgccggcctcgccatcatcgtccccctccccctcgacacctacggccgcaaccgcctcaagatccactccggcaaggacgtcttcttcatgccccccgagaagggcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10695 - RNA, 9879 nt, synthetic construct
  misc_feature 1..9879: note = derived and/or modified CDS sequence (opt2) from DENV-1__GU131963__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccaggtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10696 - RNA, 9879 nt, synthetic construct
  misc_feature 1..9879: note = derived and/or modified CDS sequence (opt2) from DENV-1__KF955442__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgacggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10697 - RNA, 9879 nt, synthetic construct
  misc_feature 1..9879: note = derived and/or modified CDS sequence (opt2) from DENV-1__GU131965__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggtcctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgcaacacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgccaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10698 - RNA, 9879 nt, synthetic construct
  misc_feature 1..9879: note = derived and/or modified CDS sequence (opt2) from DENV-1__GU131966__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctaccgccgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10699 - RNA, 9879 nt, synthetic construct
  misc_feature 1..9879: note = derived and/or modified CDS sequence (opt2) from DENV-1__GQ868501__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaaccagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaagaccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatcctcatggccacctacggctggaacctcgtcgagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10700 - RNA, 9879 nt, synthetic construct
  misc_feature 1..9879: note = derived and/or modified CDS sequence (opt2) from DENV-1__HQ166035__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccgcctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccatgctcgccgtctccggcgtctaccccatgtccatccccgccacccccttcgtctggtacttctggcagaagaagaagcagcgcatccgcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgaggagaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10701 - RNA, 9879 nt, synthetic construct
  misc_feature 1..9879: note = derived and/or modified CDS sequence (opt2) from DENV-1__GQ868502__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcaccatcttcatcctcctcatgctcgccaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagaccgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatggtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10702 - RNA, 9879 nt, synthetic construct
  misc_feature 1..9879: note = derived and/or modified CDS sequence (opt2) from DENV-1__GQ868503__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccagaacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgagcgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagcgcaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcatcttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10703 - RNA, 9879 nt, synthetic construct
  misc_feature 1..9879: note = derived and/or modified CDS sequence (opt2) from DENV-1__GQ868504__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagggcgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtaccccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10704 - RNA, 9879 nt, synthetic construct
  misc_feature 1..9879: note = derived and/or modified CDS sequence (opt2) from DENV-1__GU131967__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagacctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacggcgagcccatccccctcgccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10705 - RNA, 9879 nt, synthetic construct
  misc_feature 1..9879: note = derived and/or modified CDS sequence (opt2) from DENV-1__GU131968__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccagaacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgagcgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagcgcaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10706 - RNA, 9879 nt, synthetic construct
  misc_feature 1..9879: note = derived and/or modified CDS sequence (opt2) from DENV-1__GQ868506__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccggccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10707 - RNA, 9879 nt, synthetic construct
  misc_feature 1..9879: note = derived and/or modified CDS sequence (opt2) from DENV-1__GQ868507__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggatcaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccatgcccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatggtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctcccctccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10708 - RNA, 9879 nt, synthetic construct
  misc_feature 1..9879: note = derived and/or modified CDS sequence (opt2) from DENV-1__GQ868508__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggatcaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccatgcccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatggtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10709 - RNA, 9879 nt, synthetic construct
  misc_feature 1..9879: note = derived and/or modified CDS sequence (opt2) from DENV-1__GQ868509__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagatgtccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgtcacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcctctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10710 - RNA, 9879 nt, synthetic construct
  misc_feature 1..9879: note = derived and/or modified CDS sequence (opt2) from DENV-1__GQ868510__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcggccaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacatccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaaggacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcggcaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10711 - RNA, 9879 nt, synthetic construct
  misc_feature 1..9879: note = derived and/or modified CDS sequence (opt2) from DENV-1__GQ868511__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcacctgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagaagaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacgcctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagtccttctgggacctcgtccacaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatgggcgtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10712 - RNA, 9879 nt, synthetic construct
  misc_feature 1..9879: note = derived and/or modified CDS sequence (opt2) from DENV-1__GQ868512__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10713 - RNA, 9879 nt, synthetic construct
  misc_feature 1..9879: note = derived and/or modified CDS sequence (opt2) from DENV-1__GU131970__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagaccatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaaggacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccacccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctcaaggagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10714 - RNA, 9879 nt, synthetic construct
  misc_feature 1..9879: note = derived and/or modified CDS sequence (opt2) from DENV-1__KF955427__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgcctggaccggcgccaccgagatccagacctccggcaccaccaccatcttcgccggccacctcaagtggcgcctcaagatggacaagctcaccctcaagggcacctcctacgtcatgtgcaccggctccttcaagctcgagaaggaggtcgccgagacccagcacggcaccggcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctccccgaccccctcatcgccggcggcatcctcatcgcctgctacgtcatctccggctcctccgccgacctctccctcgagaaggccgccgagatgtcctgggagcaggaggccgagcactccggcacctcccacaacatcctcgtcgaggtccaggacgacggccccatgaagatcaaggacgaggagcgcgacgacaccctcaccatcctcctcaaggccaccctcctcgccgtctccggcgtctaccccatgtccatccccggcaccctcttcgtctggtacttctggcagaagaagaagcagcgctccggcgtcctctgggacaccccctccccccccaaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccatctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10715 - RNA, 9879 nt, synthetic construct
  misc_feature 1..9879: note = derived and/or modified CDS sequence (opt2) from DENV-1__GQ868513__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcccaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggatcaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccatgcccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatggtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10716 - RNA, 9879 nt, synthetic construct
  misc_feature 1..9879: note = derived and/or modified CDS sequence (opt2) from DENV-1__GU131973__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagatgcgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10717 - RNA, 9879 nt, synthetic construct
  misc_feature 1..9879: note = derived and/or modified CDS sequence (opt2) from DENV-1__GQ868517__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10718 - RNA, 9879 nt, synthetic construct
  misc_feature 1..9879: note = derived and/or modified CDS sequence (opt2) from DENV-1__GU131976__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccctcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctcaaggcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10719 - RNA, 9879 nt, synthetic construct
  misc_feature 1..9879: note = derived and/or modified CDS sequence (opt2) from DENV-1__GQ868518__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcccctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccgcggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacctcccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10720 - RNA, 9879 nt, synthetic construct
  misc_feature 1..9879: note = derived and/or modified CDS sequence (opt2) from DENV-1__GQ868519__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggatcaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccatgcccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatggtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10721 - RNA, 9879 nt, synthetic construct
  misc_feature 1..9879: note = derived and/or modified CDS sequence (opt2) from DENV-1__KF955443__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagatgtccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgtcacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcctctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaccctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10722 - RNA, 9879 nt, synthetic construct
  misc_feature 1..9879: note = derived and/or modified CDS sequence (opt2) from DENV-1__GQ868520__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccatgcccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatggtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10723 - RNA, 9879 nt, synthetic construct
  misc_feature 1..9879: note = derived and/or modified CDS sequence (opt2) from DENV-1__GQ868522__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggatcaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccatgcccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatggtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggcccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10724 - RNA, 9879 nt, synthetic construct
  misc_feature 1..9879: note = derived and/or modified CDS sequence (opt2) from DENV-1__HQ166036__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccgcggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacctcccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10725 - RNA, 9879 nt, synthetic construct
  misc_feature 1..9879: note = derived and/or modified CDS sequence (opt2) from DENV-1__GU131981__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcatggtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggatcaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccatgcccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatggtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10726 - RNA, 9879 nt, synthetic construct
  misc_feature 1..9879: note = derived and/or modified CDS sequence (opt2) from DENV-1__GQ868529__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagaccgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagatcgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatggtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatgctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggcctcggccacgaggaccccatccccatggccacctacggctggaacctcgtcaagctcctcgccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10727 - RNA, 9879 nt, synthetic construct
  misc_feature 1..9879: note = derived and/or modified CDS sequence (opt2) from DENV-1__GQ868531__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctcctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10728 - RNA, 9879 nt, synthetic construct
  misc_feature 1..9879: note = derived and/or modified CDS sequence (opt2) from DENV-1__GU131983__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgatcggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgaggagatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10729 - RNA, 9879 nt, synthetic construct
  misc_feature 1..9879: note = derived and/or modified CDS sequence (opt2) from DENV-1__GQ868532__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggatcaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggcaactccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccatgcccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccccccccgagatcgaggacgaggtcttcaagaagcgcaacctcaccatcatggacctccaccccggctccggcaagacccgccgctacctccccgccatggtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcaccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgcccaacgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacggcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10730 - RNA, 9879 nt, synthetic construct
  misc_feature 1..9879: note = derived and/or modified CDS sequence (opt2) from DENV-1__GQ868533__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcgaggccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcctctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacctcccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgccaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagtcctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10731 - RNA, 9879 nt, synthetic construct
  misc_feature 1..9879: note = derived and/or modified CDS sequence (opt2) from DENV-1__GQ868534__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagaacgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10732 - RNA, 9879 nt, synthetic construct
  misc_feature 1..9879: note = derived and/or modified CDS sequence (opt2) from DENV-1__GQ868535__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcgccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacatgggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10733 - RNA, 9879 nt, synthetic construct
  misc_feature 1..9879: note = derived and/or modified CDS sequence (opt2) from DENV-1__KJ189306__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggccccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttccacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcatccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10734 - RNA, 9879 nt, synthetic construct
  misc_feature 1..9879: note = derived and/or modified CDS sequence (opt2) from DENV-1__KJ189307__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatccccgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagaacgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10735 - RNA, 9879 nt, synthetic construct
  misc_feature 1..9879: note = derived and/or modified CDS sequence (opt2) from DENV-1__KJ189318__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaagaccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10736 - RNA, 9879 nt, synthetic construct
  misc_feature 1..9879: note = derived and/or modified CDS sequence (opt2) from DENV-1__KJ189319__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10737 - RNA, 9879 nt, synthetic construct
  misc_feature 1..9879: note = derived and/or modified CDS sequence (opt2) from DENV-1__KJ189320__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcaccgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10738 - RNA, 9879 nt, synthetic construct
  misc_feature 1..9879: note = derived and/or modified CDS sequence (opt2) from DENV-1__KJ189323__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggccccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccagggcggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtccgcccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10739 - RNA, 9879 nt, synthetic construct
  misc_feature 1..9879: note = derived and/or modified CDS sequence (opt2) from DENV-1__KJ189324__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgaggagatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10740 - RNA, 9879 nt, synthetic construct
  misc_feature 1..9879: note = derived and/or modified CDS sequence (opt2) from DENV-1__KJ189325__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcaccatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggatcaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccatgcccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatggtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10741 - RNA, 9879 nt, synthetic construct
  misc_feature 1..9879: note = derived and/or modified CDS sequence (opt2) from DENV-1__KJ189326__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcaccatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggcctctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatggtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10742 - RNA, 9879 nt, synthetic construct
  misc_feature 1..9879: note = derived and/or modified CDS sequence (opt2) from DENV-1__KJ189327__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacacccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10743 - RNA, 9879 nt, synthetic construct
  misc_feature 1..9879: note = derived and/or modified CDS sequence (opt2) from DENV-1__KJ189328__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaaggacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccacccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatcgaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctcaaggagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10744 - RNA, 9879 nt, synthetic construct
  misc_feature 1..9879: note = derived and/or modified CDS sequence (opt2) from DENV-1__KJ189329__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacgcctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgctccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacctcccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctaccgcacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10745 - RNA, 9879 nt, synthetic construct
  misc_feature 1..9879: note = derived and/or modified CDS sequence (opt2) from DENV-1__KJ189331__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgatcggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaagaccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgccatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10746 - RNA, 9879 nt, synthetic construct
  misc_feature 1..9879: note = derived and/or modified CDS sequence (opt2) from DENV-1__KJ189332__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcaccatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaagaccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgccatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10747 - RNA, 9879 nt, synthetic construct
  misc_feature 1..9879: note = derived and/or modified CDS sequence (opt2) from DENV-1__KJ189334__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaaggtctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagaacgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10748 - RNA, 9879 nt, synthetic construct
  misc_feature 1..9879: note = derived and/or modified CDS sequence (opt2) from DENV-1__KJ189335__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagaacgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10749 - RNA, 9879 nt, synthetic construct
  misc_feature 1..9879: note = derived and/or modified CDS sequence (opt2) from DENV-1__KJ189336__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10750 - RNA, 9879 nt, synthetic construct
  misc_feature 1..9879: note = derived and/or modified CDS sequence (opt2) from DENV-1__KJ189337__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagatctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagcgcaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacgtcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10751 - RNA, 9879 nt, synthetic construct
  misc_feature 1..9879: note = derived and/or modified CDS sequence (opt2) from DENV-1__KJ189340__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccaccggcggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10752 - RNA, 9879 nt, synthetic construct
  misc_feature 1..9879: note = derived and/or modified CDS sequence (opt2) from DENV-1__KJ189341__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcggccaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggccccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgtcgtcggcatcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacacccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaaggacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagccctccaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcatccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagctccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10753 - RNA, 9879 nt, synthetic construct
  misc_feature 1..9879: note = derived and/or modified CDS sequence (opt2) from DENV-1__KJ189343__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcgtcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgatcggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaagaccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgccatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccaccttcgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10754 - RNA, 9879 nt, synthetic construct
  misc_feature 1..9879: note = derived and/or modified CDS sequence (opt2) from DENV-1__KJ189344__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcgtcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10755 - RNA, 9879 nt, synthetic construct
  misc_feature 1..9879: note = derived and/or modified CDS sequence (opt2) from DENV-1__KJ189346__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagatgtccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcatggagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcctctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacctcccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgccaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccaccgcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcctccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10756 - RNA, 9879 nt, synthetic construct
  misc_feature 1..9879: note = derived and/or modified CDS sequence (opt2) from DENV-1__KJ189347__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggccccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcatggcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtccgcccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggccgctgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10757 - RNA, 9879 nt, synthetic construct
  misc_feature 1..9879: note = derived and/or modified CDS sequence (opt2) from DENV-1__KJ189348__SS-prME
  source 1..9879: mol_type = other RNA
tccgtcaccatgctcctcatgctcctccccaccgccctcgccttccacctcaccacccgcggcggcgagccccacatgatcgtctccaagcacgagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccttctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcatcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgcgcatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcaactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10758 - RNA, 9879 nt, synthetic construct
  misc_feature 1..9879: note = derived and/or modified CDS sequence (opt2) from DENV-1__KJ189368__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaacggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggccccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccatctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagttcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcttcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10759 - RNA, 9879 nt, synthetic construct
  misc_feature 1..9879: note = derived and/or modified CDS sequence (opt2) from DENV-1__KJ189369__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagaacgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgagatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10760 - RNA, 9879 nt, synthetic construct
  misc_feature 1..9879: note = derived and/or modified CDS sequence (opt2) from DENV-1__EU482615__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagtccgagtccgaccccgagggcgccctctggtga

SEQ ID NO: 10761 - RNA, 9879 nt, synthetic construct
  misc_feature 1..9879: note = derived and/or modified CDS sequence (opt2) from DENV-1__EU482616__SS-prME
  source 1..9879: mol_type = other RNA
tccgtcaccatgctcctcatgctcctccccaccgccctcgccttccacctcaccacccgcggcggcgagccccacatgatcgtcaacaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccaagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10762 - RNA, 9879 nt, synthetic construct
  misc_feature 1..9879: note = derived and/or modified CDS sequence (opt2) from DENV-1__EU482618__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10763 - RNA, 9879 nt, synthetic construct
  misc_feature 1..9879: note = derived and/or modified CDS sequence (opt2) from DENV-1__EU482619__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcgtcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10764 - RNA, 9879 nt, synthetic construct
  misc_feature 1..9879: note = derived and/or modified CDS sequence (opt2) from DENV-1__FJ898433__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgactcctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaaggacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccacccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcggcaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctcaaggagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10765 - RNA, 9879 nt, synthetic construct
  misc_feature 1..9879: note = derived and/or modified CDS sequence (opt2) from DENV-1__FJ547088__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccggccgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10766 - RNA, 9879 nt, synthetic construct
  misc_feature 1..9879: note = derived and/or modified CDS sequence (opt2) from DENV-1__FJ810419__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10767 - RNA, 9879 nt, synthetic construct
  misc_feature 1..9879: note = derived and/or modified CDS sequence (opt2) from DENV-1__FJ547068__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgccgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10768 - RNA, 9879 nt, synthetic construct
  misc_feature 1..9879: note = derived and/or modified CDS sequence (opt2) from DENV-1__FJ562104__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10769 - RNA, 9879 nt, synthetic construct
  misc_feature 1..9879: note = derived and/or modified CDS sequence (opt2) from DENV-1__GQ199857__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcatctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10770 - RNA, 9879 nt, synthetic construct
  misc_feature 1..9879: note = derived and/or modified CDS sequence (opt2) from DENV-1__GQ199858__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcatctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggcctcggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10771 - RNA, 9879 nt, synthetic construct
  misc_feature 1..9879: note = derived and/or modified CDS sequence (opt2) from DENV-1__GQ199859__SS-prME
  source 1..9879: mol_type = other RNA
tccgtcaccatgctcctcatgctcctccccaccgccctcgccttccacctcaccacccgcggcggcgagccccacatgatcgtctccaagcacgagcgcggcaagtccctcctcttcaagacctccaccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcatcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgtacctcatcaccgagaacaagatctggggccgcaagtcctggcccatcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgcgcatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10772 - RNA, 9879 nt, synthetic construct
  misc_feature 1..9879: note = derived and/or modified CDS sequence (opt2) from DENV-1__JF937645__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10773 - RNA, 9879 nt, synthetic construct
  misc_feature 1..9879: note = derived and/or modified CDS sequence (opt2) from DENV-1__FJ850114__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcacctcccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagacctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagatcctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgatctccatgaagcgcttcaagaacgagtccgaccccgagggcgccctctggtga

SEQ ID NO: 10774 - RNA, 9879 nt, synthetic construct
  misc_feature 1..9879: note = derived and/or modified CDS sequence (opt2) from DENV-1__JN819402__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatgaccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgcctcatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagtccgagtccgaccccgagggcgccctctggtga

SEQ ID NO: 10775 - RNA, 9879 nt, synthetic construct
  misc_feature 1..9879: note = derived and/or modified CDS sequence (opt2) from DENV-1__FJ850113__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgcctcatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagtccgagtccgaccccgagggcgccctctggtga

SEQ ID NO: 10776 - RNA, 9879 nt, synthetic construct
  misc_feature 1..9879: note = derived and/or modified CDS sequence (opt2) from DENV-1__JF937635__SS-prME
  source 1..9879: mol_type = other RNA
tccgtcaccatgctcctcatgctcatgcccaccgccctcgccttccacctcaccacccgcggcggcgagccccacatgatcgtctccaagcacgagcgcggcaaggccctcctcttcaagacctccaccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcatcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgcgcatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccccccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10777 - RNA, 9879 nt, synthetic construct
  misc_feature 1..9879: note = derived and/or modified CDS sequence (opt2) from DENV-1__FJ024483__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctactacacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10778 - RNA, 9879 nt, synthetic construct
  misc_feature 1..9879: note = derived and/or modified CDS sequence (opt2) from DENV-1__EU596504__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcttcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcatgccccccgagaagtgcgacaccctcctctgcgacatcggcgagtcctcccccaaccccaccatcgaggagggccgcaccctccgcatcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10779 - RNA, 9879 nt, synthetic construct
  misc_feature 1..9879: note = derived and/or modified CDS sequence (opt2) from DENV-1__FJ024481__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcatgccccccgagaagtgcgacaccctcctctgcgacatcggcgagtcctcccccaaccccaccatcgaggagggccgcaccctccgcatcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10780 - RNA, 9879 nt, synthetic construct
  misc_feature 1..9879: note = derived and/or modified CDS sequence (opt2) from DENV-1__GQ199872__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgaccacatgacctccatgaagcgcttcaagaacgagtccgaccccgagggcgccctctggtga

SEQ ID NO: 10781 - RNA, 9879 nt, synthetic construct
  misc_feature 1..9879: note = derived and/or modified CDS sequence (opt2) from DENV-1__FJ410290__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcacctcccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgtcgtcttcctcctcctcatcatgggccagctcacctggaaggacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgcttcgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcggcaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccaccaacgccaagtgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgcgccgcttcaagaacgagtccgaccccgagggcgccctctggtga

SEQ ID NO: 10782 - RNA, 9879 nt, synthetic construct
  misc_feature 1..9879: note = derived and/or modified CDS sequence (opt2) from DENV-1__FJ024423__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcgtcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccatcatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccaagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10783 - RNA, 9879 nt, synthetic construct
  misc_feature 1..9879: note = derived and/or modified CDS sequence (opt2) from DENV-1__FJ547089__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagaccatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcgtccccgcccgcgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcgtcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10784 - RNA, 9879 nt, synthetic construct
  misc_feature 1..9879: note = derived and/or modified CDS sequence (opt2) from DENV-1__FJ024484__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcgtcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgcccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctcaccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacggcttcttcatgccccccgagaagtgcggcaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccaagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10785 - RNA, 9879 nt, synthetic construct
  misc_feature 1..9879: note = derived and/or modified CDS sequence (opt2) from DENV-1__EU596503__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcatcggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcatgttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcaccggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10786 - RNA, 9879 nt, synthetic construct
  misc_feature 1..9879: note = derived and/or modified CDS sequence (opt2) from DENV-1__FJ024479__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcttcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccgccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgcccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaccacccccgagggcatcatccccgccctcttcgagcccgagcgcgagaagtccgccgccatcgacggcgagtcccgcctccgcggcgagccccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggcccaaggagggcgagcgcaagaagctccgcccccgctggctcgacgcccgcacctactccgaccccctcgccctcggcgagttcaaggagttcggcgccggccgccgctccggctccggcgccctcatcctcgagatcggcaagctcccccagcacctccccctccgcgcccagaacggcctcgacaacctcgtcatggtccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgccaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctggacctcccagatcctcctcatgcgcaccacctgggccctcggcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaaccccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcggcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatggactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcgtcgtcgacgagaaccagtggaactccgccaaggaggccggcgaggacgagcgcgtctgggacctcggcgaccgcgagcgcgagctccacaagcagggcaagtgcgccacctgcggctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgcccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtcgccttctggtcccaccacttccaccagctcatcatgaaggacggccgcgagatcgtcgtcccctgccgcaaccaggacgagctcggcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10787 - RNA, 9879 nt, synthetic construct
  misc_feature 1..9879: note = derived and/or modified CDS sequence (opt2) from DENV-1__FJ182002__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcaccggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcacccagaccaaggagggcgaccagtacgtctacatgggccagcccctcaacaacgacgaggaccacgcccactggaccgaggccaagatgctcctcgccaacatcaacacccccgagggcatcatccccgccctcttcgagcccgagcgcgagaagtcccccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtggttcgacggcgagcgcaacaaccaggtcctcgaggagaacatggacgtcgagatctggaccaaggagggcgagcgcaagaagctccgcccccgctggctcgacgcccgcacctactccgaccccctcgccctcggcgagttcaaggagttcggcgccggccgccgctccggctccggcgacctcatcctcgagatcggcaagctcccccagcacctcaccctccgcgcccagaacggcctcgacaacctcgtcatggtccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccggcgaggacgagcgcgtctgggacctcgtcgaccgcgagcgcgagctccacaagcagggcaagtggggcaccggcggctacaacatgatgggcaagcgcgagaagaagctcggcgagttcggcaaggccaagggctcccgcggcatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatgcccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctggtcccaccacttccaccagctcatcatgaaggacggccgcgagatcgtcgtcccctgccgcaaccaggacgagctcgtcggccgcgcccgcgtctcccagggcgccggctggtccctccgcgagaccgcctggctcggcaagtcctacgcccagatgggccagctcatgtacttccaccgccgcgacctccgcctcgccgccaacgccatctggtccgccggccccggcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10788 - RNA, 9879 nt, synthetic construct
  misc_feature 1..9879: note = derived and/or modified CDS sequence (opt2) from DENV-1__FJ024482__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggcccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatggtccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcctcatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgcccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgccatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10789 - RNA, 9879 nt, synthetic construct
  misc_feature 1..9879: note = derived and/or modified CDS sequence (opt2) from DENV-1__EU596501__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcctccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagaccctcgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactcctcccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10790 - RNA, 9879 nt, synthetic construct
  misc_feature 1..9879: note = derived and/or modified CDS sequence (opt2) from DENV-1__FJ898437__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgtcaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcgtcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10791 - RNA, 9879 nt, synthetic construct
  misc_feature 1..9879: note = derived and/or modified CDS sequence (opt2) from DENV-1__FJ024480__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcatggcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10792 - RNA, 9879 nt, synthetic construct
  misc_feature 1..9879: note = derived and/or modified CDS sequence (opt2) from DENV-1__FJ873814__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcgtcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccatcatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagtccatccccatggccacctacgcctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccaagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10793 - RNA, 9879 nt, synthetic construct
  misc_feature 1..9879: note = derived and/or modified CDS sequence (opt2) from DENV-1__JN819403__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgagggccccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10794 - RNA, 9879 nt, synthetic construct
  misc_feature 1..9879: note = derived and/or modified CDS sequence (opt2) from DENV-1__KF973453__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcatctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10795 - RNA, 9879 nt, synthetic construct
  misc_feature 1..9879: note = derived and/or modified CDS sequence (opt2) from DENV-1__KF973454__SS-prME
  source 1..9879: mol_type = other RNA
tccgtcaccatgctcctcatgctcctccccaccgccctcgccttccacctcaccacccgcggcggcgagccccacatgatcgtctccaagcacgagcgcggcaagtccctcctcttcaagacctccaccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcgccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagctccgccccatgttcgccgtcggcatcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccatctgcctctccaccacctcccagaagaccacctggctccccgtcctcctcggctccttcggctgcaagcccctcaccatgtacctcatcaccgagaacaagatctggggccgcaagtcctggcccatcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgcgcatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagtccgccctcgacaacctcgtcatgctccacaactccgagcagggcggcaaggcctaccgccacgccatggaggagctccccgacaccatcgagaccctcatgctcctcgccctcatcgccgtcctcaccggcggcgtcatgctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcaccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgtcctctggtga

SEQ ID NO: 10796 - RNA, 9879 nt, synthetic construct
  misc_feature 1..9879: note = derived and/or modified CDS sequence (opt2) from DENV-1__KF973455__SS-prME
  source 1..9879: mol_type = other RNA
tccgtcaccatgctcctcatgctcctccccaccgccctcgccttccacctcaccacccgcggcggcgagccccacatgatcgtctccaagcacgagcgcggcaagtccctcctcttcaagacctccaccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcgccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagctccgccccatgttcgccgtcggcatcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccatctgcctctccaccacctcccagaagaccacctggctccccgtcctcctcggctccttcggctgcaagcccctcaccatgtacctcatcaccgagaacaagatctggggccgcaagtcctggcccatcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgcgcatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcatgctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcaccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10797 - RNA, 9879 nt, synthetic construct
  misc_feature 1..9879: note = derived and/or modified CDS sequence (opt2) from DENV-1__KF973456__SS-prME
  source 1..9879: mol_type = other RNA
tccgtcaccatgctcctcatgctcctccccaccgccctcgccttccacctcaccacccgcggcggcgagccccacatgatcgtctccaagcacgagcgcggcaagtccctcctcttcaagacctccaccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcgccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagctccgccccatgttcgccgtcggcatcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccatctgcctctccaccacctcccagaagaccacctggctccccgtcctcctcggctccttcggctgcaagcccctcaccatgtacctcatcaccgagaacaagatctggggccgcaagtcctggcccatcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgcgcatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcatgctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcaccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10798 - RNA, 9879 nt, synthetic construct
  misc_feature 1..9879: note = derived and/or modified CDS sequence (opt2) from DENV-1__KF973459__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccctctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcatctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggtctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccaagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10799 - RNA, 9879 nt, synthetic construct
  misc_feature 1..9879: note = derived and/or modified CDS sequence (opt2) from DENV-1__KF973460__SS-prME
  source 1..9879: mol_type = other RNA
tccgtcaccatgctcctcatgctcctccccaccgccctcgccttccacctcaccacccgcggcggcgagccccacatgatcgtctccaagcacgagcgcggcaagtccctcctcttcaagacctccaccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcgccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccctctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagctccgccccatgttcgccgtcggcatcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgtacttcatcaccgagaacaagatctggggccgcaagtcctggcccatcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgcgcatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcatctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagtcctacctcgactacatgacctccatgaagcgcttcaagaacgagtccgaccccgagggcgccctctggtga

SEQ ID NO: 10800 - RNA, 9879 nt, synthetic construct
  misc_feature 1..9879: note = derived and/or modified CDS sequence (opt2) from DENV-1__KF973461__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatgggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgagctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagatcaccgccatggccctctccatcatctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10801 - RNA, 9879 nt, synthetic construct
  misc_feature 1..9879: note = derived and/or modified CDS sequence (opt2) from DENV-1__KF973462__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccagatcatcgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggagatggccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcatctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggtctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtccgcctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccaagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaagatccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10802 - RNA, 9879 nt, synthetic construct
  misc_feature 1..9879: note = derived and/or modified CDS sequence (opt2) from DENV-1__KF973463__SS-prME
  source 1..9879: mol_type = other RNA
tccgtcaccatgctcctcatgctcatgcccaccgccctcgccttccacctcaccacccgcggcggcgagccccacatgatcgtctccaagcacgagcgcggcaaggccctcctcttcaagacctccaccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcatcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgcgcatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggacgaggtcttcaagaagcgcaacctcaccatcatggacctccaccccggctccggcaagacccgccgctacctccccgccatcgtccgcgaggccatcaagaagaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10803 - RNA, 9879 nt, synthetic construct
  misc_feature 1..9879: note = derived and/or modified CDS sequence (opt2) from DENV-1__KF973464__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcatctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcatcttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatggtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10804 - RNA, 9879 nt, synthetic construct
  misc_feature 1..9879: note = derived and/or modified CDS sequence (opt2) from DENV-1__KF973465__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatgggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgagctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcatctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10805 - RNA, 9879 nt, synthetic construct
  misc_feature 1..9879: note = derived and/or modified CDS sequence (opt2) from DENV-1__KF973466__SS-prME
  source 1..9879: mol_type = other RNA
tccgtcaccatgctcctcatgctcatgcccaccgccctcgccttccacctcaccacccgcggcggcgagccccacatgatcgtctccaagcacgagcgcggcaaggccctcctcttcaagacctccaccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcatcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgcgcatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10806 - RNA, 9879 nt, synthetic construct
  misc_feature 1..9879: note = derived and/or modified CDS sequence (opt2) from DENV-1__KF973471__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcacccccgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcatctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcaccgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccgtcgaggagggccgcaccctccgcgtcctcaagatggtcgagccctggctcaagggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10807 - RNA, 9879 nt, synthetic construct
  misc_feature 1..9879: note = derived and/or modified CDS sequence (opt2) from DENV-1__KF973472__SS-prME
  source 1..9879: mol_type = other RNA
tccgtcaccatgctcctcatgctcctccccaccgccctcgccttccacctcaccacccgcggcggcgagccccacatgatcgtctccaagcacgagcgcggcaagtccctcctcttcaagacctccaccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcgccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccgtcacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagctccgccccatgttcgccgtcggcatcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatccgcaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgtacttcatcaccgagaacaagatctggggccgcaagtcctggcccatcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccgcgacgacggcaccatgcgcatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagtcctacctcgactacatgacctccatgaagcgcttcaagaacgagtccgaccccgagggcgccctctggtga

SEQ ID NO: 10808 - RNA, 9879 nt, synthetic construct
  misc_feature 1..9879: note = derived and/or modified CDS sequence (opt2) from DENV-1__KF973474__SS-prME
  source 1..9879: mol_type = other RNA
tccgtcaccatgctcctcatgctcctccccaccgccctcgccttccacctcaccacccgcggcggcgagccccacatgatcgtctccaagcacgagcgcggcaagtccctcctcttcaagacctccaccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcgccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagctccgccccatgttcgccgtcggcatcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgtacctcatcaccgagaacaagatctggggccgcaagtcctggcccatcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgcgcatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccgtccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcaccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10809 - RNA, 9879 nt, synthetic construct
  misc_feature 1..9879: note = derived and/or modified CDS sequence (opt2) from DENV-1__KF973475__SS-prME
  source 1..9879: mol_type = other RNA
tccgtcaccatgctcctcatgctcatgcccaccgccctcgccttccacctcaccacccgcggcggcgagccccacatgatcgtctccaagcacgagcgcggcaaggccctcctcttcaagacctccaccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcatcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgcgcatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10810 - RNA, 9879 nt, synthetic construct
  misc_feature 1..9879: note = derived and/or modified CDS sequence (opt2) from DENV-1__FJ898448__SS-prME
  source 1..9879: mol_type = other RNA
tccgtcaccatgctcctcatgctcctccccaccgtcctcaccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgacgacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcgtcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagaccatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgtcgtcttcctcctcctcaccctcggccagctcacctggaacgacctcatccgcctctgcatcatggtcggcgccaacgcctccgacaacatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgacgagctcggcgacggcctcgccatgggcatcatgatcctcaagctcctcaccgacttccagtcccaccagctctgggccaccctcctctccctcaccttcgtcaagaccaccctctccctccactacgcctggaagaccatggccatgatcctctccatcgtctccctcctccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccaaggtctcctgggaggaggaggccgagcactccggcgcctcccacaacatcctcgtcgagatccaggacgacggcaccatgaagatcaaggacgaggagcgcgacgacaccatcaccatcctcctcaaggccaccctcctcgccatctccggcgtctaccccatgtccatccccgccaccctcttcgtctggcacttctggcagaagaagaagcagcgctccggcgtcctctgggacaccccctccccccccgaggtcgagaaggccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccatcatgctcctcgccctcatcgccgtcctcaccggcggcgtcaccctcttcttcctctccggccgcggcctcggcaagacctccatcggcctcctctgcgtcacctcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcaccgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10811 - RNA, 9879 nt, synthetic construct
  misc_feature 1..9879: note = derived and/or modified CDS sequence (opt2) from DENV-1__GQ868602__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcatcaccgccaaccccatcgtcaccgacaaggagaagcccgtcaacatcgaggccgagccccccttcggcgagtcctacctcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcaacggcgtcctcgcccagggcaagaagatgatccgcccccagcccatggagcacaagtactcctggaagtcctggggcaaggccaaggtcatcggcgccgacgtccagaacatcaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcacccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcggcctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagtcccaccagctctgggccaccctcctctccctcaccttcgtcaagaccaccttctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggcaagtcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacatgggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccatggaggccttcccccagtccaacgccgccatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcgtccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcctcaagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagtcccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaaggtcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgcaacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcatcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagaacgaccccgagggcgccctctggtga

SEQ ID NO: 10812 - RNA, 9879 nt, synthetic construct
  misc_feature 1..9879: note = derived and/or modified CDS sequence (opt2) from DENV-1__KF921911__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggaaccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtctccctctacggcaacggcgtcgtcaccacctccggcacctacgtctccgccatcgcccaggccaagacctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtctaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10813 - RNA, 9879 nt, synthetic construct
  misc_feature 1..9879: note = derived and/or modified CDS sequence (opt2) from DENV-1__KJ189350__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaacggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcgtcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggagaacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10814 - RNA, 9879 nt, synthetic construct
  misc_feature 1..9879: note = derived and/or modified CDS sequence (opt2) from DENV-1__KJ189351__SS-prME
  source 1..9879: mol_type = other RNA
tccgtcaccatgctcctcatgctcctccccaccgtcctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacccccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcacccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcgccgagaaccgcatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcgtcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagtcctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10815 - RNA, 9879 nt, synthetic construct
  misc_feature 1..9879: note = derived and/or modified CDS sequence (opt2) from DENV-1__KJ189352__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaaggtcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcgtcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggagaacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10816 - RNA, 9879 nt, synthetic construct
  misc_feature 1..9879: note = derived and/or modified CDS sequence (opt2) from DENV-1__KJ189353__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgagctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcgtcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggagaacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10817 - RNA, 9879 nt, synthetic construct
  misc_feature 1..9879: note = derived and/or modified CDS sequence (opt2) from DENV-1__KJ189354__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagaagttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcgtcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggagaacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10818 - RNA, 9879 nt, synthetic construct
  misc_feature 1..9879: note = derived and/or modified CDS sequence (opt2) from DENV-1__KJ189355__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcatcgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccatgtccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcgtcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcggctggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggagaacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10819 - RNA, 9879 nt, synthetic construct
  misc_feature 1..9879: note = derived and/or modified CDS sequence (opt2) from DENV-1__KJ189358__SS-prME
  source 1..9879: mol_type = other RNA
tccgtcaccatgctcctcatgctcctccccaccgtcctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacccacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccctaccagctctggaccaccctcctctccctcaccttcgtcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagcgcaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgcaagtacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgcccagctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagaacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10820 - RNA, 9879 nt, synthetic construct
  misc_feature 1..9879: note = derived and/or modified CDS sequence (opt2) from DENV-1__KJ189359__SS-prME
  source 1..9879: mol_type = other RNA
tccgtcaccatgctcctcatgctcctccccaccgtcctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagcgcaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacaccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatcgacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaacaccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10821 - RNA, 9879 nt, synthetic construct
  misc_feature 1..9879: note = derived and/or modified CDS sequence (opt2) from DENV-1__KJ189360__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcgtcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggagaacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10822 - RNA, 9879 nt, synthetic construct
  misc_feature 1..9879: note = derived and/or modified CDS sequence (opt2) from DENV-1__KJ189361__SS-prME
  source 1..9879: mol_type = other RNA
tccgtcaccatgctcctcatgctcctccccaccgccatggccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcgtcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10823 - RNA, 9879 nt, synthetic construct
  misc_feature 1..9879: note = derived and/or modified CDS sequence (opt2) from DENV-1__KJ189362__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcatgacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtccgcaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcgtcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggagaacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10824 - RNA, 9879 nt, synthetic construct
  misc_feature 1..9879: note = derived and/or modified CDS sequence (opt2) from DENV-1__KJ189363__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcatggtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcgtcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggagaacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10825 - RNA, 9879 nt, synthetic construct
  misc_feature 1..9879: note = derived and/or modified CDS sequence (opt2) from DENV-1__KJ189364__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcatgacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtccgcaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggtccttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcgtcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggagaacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10826 - RNA, 9879 nt, synthetic construct
  misc_feature 1..9879: note = derived and/or modified CDS sequence (opt2) from DENV-1__KJ189365__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgtcgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcgtcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgacgagaacccctggatggagaacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10827 - RNA, 9879 nt, synthetic construct
  misc_feature 1..9879: note = derived and/or modified CDS sequence (opt2) from DENV-1__KJ189366__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcgccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaactccgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgtcaccatgctcgacgtcgacctccaccccgcctccgcctggaccctctacgccgtcgccaccaccgtcatcacccccatgatgcgccacaccatcgagaacgccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccgtcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccgtcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcgtcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggagaacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10828 - RNA, 9879 nt, synthetic construct
  misc_feature 1..9879: note = derived and/or modified CDS sequence (opt2) from DENV-1__JN819417__SS-prME
  source 1..9879: mol_type = other RNA
tccgtcaccatgctcctcatgctcctccccaccgccctcgccttccacctcaccacccgcggcggcgagccccacatggtcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagcacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccacgagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgcctccggcatcctcgcccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatgggcaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgagatctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccatctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccatctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcaccaagaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaacgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10829 - RNA, 9879 nt, synthetic construct
  misc_feature 1..9879: note = derived and/or modified CDS sequence (opt2) from DENV-1__FJ687426__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgccggcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctcccccaacgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 10830 - RNA, 9879 nt, synthetic construct
  misc_feature 1..9879: note = derived and/or modified CDS sequence (opt2) from DENV-1__FJ687428__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgccggcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagtccatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctcccccaacgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 10831 - RNA, 9879 nt, synthetic construct
  misc_feature 1..9879: note = derived and/or modified CDS sequence (opt2) from DENV-1__FJ687429__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctggatcgacgtcgtcctcgagcacggctcctgcatcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctcccccaacgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 10832 - RNA, 9879 nt, synthetic construct
  misc_feature 1..9879: note = derived and/or modified CDS sequence (opt2) from DENV-1__FJ850068__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgccggcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctcccccaacgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 10833 - RNA, 9879 nt, synthetic construct
  misc_feature 1..9879: note = derived and/or modified CDS sequence (opt2) from DENV-1__FJ687430__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccaccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccatcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacgccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccctcgaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgcctccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagaccgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10834 - RNA, 9879 nt, synthetic construct
  misc_feature 1..9879: note = derived and/or modified CDS sequence (opt2) from DENV-1__FJ687432__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccaccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccatcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacgccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccctcgaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgcctccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagaccgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10835 - RNA, 9879 nt, synthetic construct
  misc_feature 1..9879: note = derived and/or modified CDS sequence (opt2) from DENV-1__JQ922547__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccccctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaactgcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccacccacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgccacccagaacggccgcctcatcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgctcgaggccaccgcccgcggcgcccgccgcatggccatcctcggcgacaccgcctgggacttcggctccatcggcggcgtcttcacctccatgggcaagctcgtccaccaggtcttcggcaccgcctacggcgtcctcttctccggcgtctcctggaccatgaagatcggcatcggcatcctcctcacctggctcggcctcaactcccgcaacacctccctctccatgatgtgcatcgccgtcggcatggtcaccctctacctcggcgtcatggtccaggccgactccggctgcgtcatcaactggaagggccgcgagctcctctgcggcaccggcatcttcgtcaccaacgaggtccacacctggaccgacccctacaagttccaggccgacccctccaaccgcctctcccccatcatcggcaaggcctgcgtcatccgcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcgagaagatgatccgcccccagcccatggagcacaagtactcctggaagtcctggggcaaggccaagatcatcggcgccgacgtccagaacaccaccttcatcatcgacggccccaacacccccgagtgccccgacaaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacttctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggacaaggaggagaacctcgtcaagtccatggtctccgccggctccggcgaggtcgactccttctccctcggcctcctctgcatctccatcatgatcgaggaggtcatgcgctcccgctggtccaagaagatgctcatggtcggcaccctcgccgtcttcctcctcctcatcatgggccagctcacctggtccgacctcatccgcctctgcatcatggtcggcgccaacgcctccgaccgcatgggcatgggcaccacctacctcgccctcatggccaccttcaagatgcgccccatgttcgccgtcggcctcctcttccccaagctcacctcccgcgaggtcctcctcctcaccatcggcctctccctcgtcgcctccgtcgagctcccctcctccctcgaggagctcggcgacggcctcgccaagggcatcatgatgctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctccccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcgtcgcctgctacgtcatctccggctcctccgccgacctctccctcgagaaggccgccgaggtctcctgggaggaggaggccgagcactccggcgcctcccacaacatcctcgtcgaggtccaggacgacggcacccgcaagatcaaggacgaggagcgcgacgacaccctcaccatcctcctcaaggccaccctcctcgccgtctccggcgtctaccccatgtccatccccgccaccctcttcgtctggtacttctggcagaagaagaaccagcgctccggcgtcggcctcatcaccccctccccccccgaggtcgagcgcgccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggccgcaaccccaagaacgtccagaccgcccccggcaccttcaagacccccgagggcgaggtcggcgccatccccctcgacttcaagcccggcacctccggctcccccatcgtcaaccgcgagggcaagatcgtcggcctctacggcaacggcgtcgtcaccacctccggcacctacgtctccgccatcgcccgcgccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcgtccccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccacccccaccggctccgtcgaggccttcccccagtccaacgccatcatccaggacgaggagcgcgacatccccgagcgctcctggaactccggctacgactggatcaccgacttccccggcaagaccgtctggttcgtcccctccatcaagtccggcaacgacatcgccaactgcctcaagaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagccctccaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacaaggacgtcgagatctggaccaaggagggcgagcgcaagaagctccgcacctgctggctcgacgcccgcacctactccgaccccctcgccctccgcgagttcaaggagttcgccgccggccgccgctccgtctccggcgacctcatcctcgagatcggcaagctcccccagcacctcacccagaaggcccagaaggccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggccgcttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacaagatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctcccgcatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgccatctcccgccgcgaccagcgcggctccggccaggtcggcacctacggcctcaacaccttcctccacaaggaggcccagctcatccgccagatggagttcgagggcatcttcctcccctccgagctcgagacccccaacctcgccggccgcgtcctcgactggctcgagcagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggggcgactggcagcaggtccccttctgctcccaccacttccaccagctcatcatgaaggacgtccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10836 - RNA, 9879 nt, synthetic construct
  misc_feature 1..9879: note = derived and/or modified CDS sequence (opt2) from DENV-1__EU482567__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccctcttcctcgcccacgccatcggcacctccatcacccagaagggcatcatcttcatcctcctcatcctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgccggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcgtcgtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaacgccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaaggacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaacaccaccctctccctcgactacgcctggcgcaccatggccatggtcctctccatcatctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggcccgcgagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctggaacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccgtcgacgagcgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10837 - RNA, 9879 nt, synthetic construct
  misc_feature 1..9879: note = derived and/or modified CDS sequence (opt2) from DENV-1__FJ390378__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaactccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggaggaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagacccgcaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcaactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10838 - RNA, 9879 nt, synthetic construct
  misc_feature 1..9879: note = derived and/or modified CDS sequence (opt2) from DENV-1__FJ205872__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaactccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggaggaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagacccgcaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgccctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcaactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10839 - RNA, 9879 nt, synthetic construct
  misc_feature 1..9879: note = derived and/or modified CDS sequence (opt2) from DENV-1__FJ205873__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaactccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgcaagctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaaggtcgtcggcctctacggcaacggcgtcgtcaccacctccggcacctacgtctccgccatcgcccaggccaagacctcccaggagggccccctccccgagatcgaggaggaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagacccgcaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcaactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10840 - RNA, 9879 nt, synthetic construct
  misc_feature 1..9879: note = derived and/or modified CDS sequence (opt2) from DENV-1__FJ390379__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggccgcaagatgatccgcccccagcccatggagcaccgctactcctggaagtcctggggcaaggccaagatcatcggcgccgacatccagaactccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggaggaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagacccgcaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccgtccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10841 - RNA, 9879 nt, synthetic construct
  misc_feature 1..9879: note = derived and/or modified CDS sequence (opt2) from DENV-1__FJ390380__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaactccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgagctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgtcgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccttcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggaggaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagacccgcaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcaactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10842 - RNA, 9879 nt, synthetic construct
  misc_feature 1..9879: note = derived and/or modified CDS sequence (opt2) from DENV-1__FJ205874__SS-prME
  source 1..9879: mol_type = other RNA
tccgtcaccatgctcctcatgctcctccccaccgtcctcgccttccacctcaccacccgcggcggcgagccccacatgatcgtcggcaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccctctccacccaggacgagaagggcgtcacccagaacggccgcctcatcaccgccaaccccatcgtcaccgacaaggagaagcccgtcaacatcgagaccgagccccccttcggcgagtcctacatcatcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccgcctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcgtccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggcgcctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcctctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccgtcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggtcctccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgaagcgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcatgctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgtcaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgccgccacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcggcatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctgggacttcctctcccgcaacaagaagccccgcatctgcacccgcgaggagttcatccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagaccaccaacctcgccgagcgcgtcctcgactggctcgagaagcacggcgtcgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10843 - RNA, 9879 nt, synthetic construct
  misc_feature 1..9879: note = derived and/or modified CDS sequence (opt2) from DENV-1__FJ205875__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtccaagaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggtccaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggctcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggtccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgacggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccgtcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10844 - RNA, 9879 nt, synthetic construct
  misc_feature 1..9879: note = derived and/or modified CDS sequence (opt2) from DENV-1__FJ410173__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaactccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccttcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggaggaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagacccgcaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcaactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10845 - RNA, 9879 nt, synthetic construct
  misc_feature 1..9879: note = derived and/or modified CDS sequence (opt2) from DENV-1__FJ410174__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatcgccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcatcacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggaggaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccgccctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggaggccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10846 - RNA, 9879 nt, synthetic construct
  misc_feature 1..9879: note = derived and/or modified CDS sequence (opt2) from DENV-1__FJ410175__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggaggaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10847 - RNA, 9879 nt, synthetic construct
  misc_feature 1..9879: note = derived and/or modified CDS sequence (opt2) from DENV-1__FJ562105__SS-prME
  source 1..9879: mol_type = other RNA
tccgtcaccatgctcctcatgctcctccccaccgtcctcgccttccacctcaccacccgcggcggcgagccccacatgatcgtcggcaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccctctccacccaggacgagaagggcgtcacccagaacggccgcctcatcaccgccaaccccatcgtcaccgacaaggagaagcccgtcaacatcgagaccgagccccccttcggcgagtcctacatcatcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccgcctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcgtccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcctctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccgtcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcatgctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgtcaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctcggcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcggcatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctgggacttcctctcccgcaacaagaagccccgcatctgcacccgcgaggagttcatccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagaccaccaacctcgccgagcgcgtcctcgactggctcgagaagcacggcgtcgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10848 - RNA, 9879 nt, synthetic construct
  misc_feature 1..9879: note = derived and/or modified CDS sequence (opt2) from DENV-1__FJ562106__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcatggtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccgcctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaagaactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcggcctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccttctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctgcgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccacccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10849 - RNA, 9879 nt, synthetic construct
  misc_feature 1..9879: note = derived and/or modified CDS sequence (opt2) from DENV-1__FJ410179__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaactccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggaggaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagacccgcaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10850 - RNA, 9879 nt, synthetic construct
  misc_feature 1..9879: note = derived and/or modified CDS sequence (opt2) from DENV-1__FJ410181__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtctaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10851 - RNA, 9879 nt, synthetic construct
  misc_feature 1..9879: note = derived and/or modified CDS sequence (opt2) from DENV-1__FJ547086__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcatggtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccgcctccctctccatgacctgcatcgccgtcggcatggtcaccctctacctcggcgtcatggtccaggccgactccggctgcgccatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccagcagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctgcgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccaaccccgagggcgccctctggtga

SEQ ID NO: 10852 - RNA, 9879 nt, synthetic construct
  misc_feature 1..9879: note = derived and/or modified CDS sequence (opt2) from DENV-1__FJ410183__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccacctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgagatggactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatcatcctcaccgtcgccgccaacgagatgggcctcctcgagaccaccaagaaggacctcggcatcggccacgtcgccgccgagtcccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10853 - RNA, 9879 nt, synthetic construct
  misc_feature 1..9879: note = derived and/or modified CDS sequence (opt2) from DENV-1__FJ410184__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagcgcgaggagaacctcgtcaagtccatggtctccgccggcctcggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggcgcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggctccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10854 - RNA, 9879 nt, synthetic construct
  misc_feature 1..9879: note = derived and/or modified CDS sequence (opt2) from DENV-1__FJ410185__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgaggagaagatcgtcggcctctacggcaacggcgtcgtcaccacctccggcacctacgtctccgccatcgcccaggccaagacctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10855 - RNA, 9879 nt, synthetic construct
  misc_feature 1..9879: note = derived and/or modified CDS sequence (opt2) from DENV-1__FJ547087__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcatggtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccgcctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggacggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccatccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctgcgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10856 - RNA, 9879 nt, synthetic construct
  misc_feature 1..9879: note = derived and/or modified CDS sequence (opt2) from DENV-1__FJ410186__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcatcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccgcctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccacctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggcctctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggcccgcgccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgaccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgatctccatgaagcgcttcaagaacgagtccgaccccgagggcgccctctggtga

SEQ ID NO: 10857 - RNA, 9879 nt, synthetic construct
  misc_feature 1..9879: note = derived and/or modified CDS sequence (opt2) from DENV-1__FJ410187__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaactccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggaggaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagacccgcaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10858 - RNA, 9879 nt, synthetic construct
  misc_feature 1..9879: note = derived and/or modified CDS sequence (opt2) from DENV-1__FJ478457__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagcacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcatgttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgcctccggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgctccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcatcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatgctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccaggtcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagaagttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgagtggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10859 - RNA, 9879 nt, synthetic construct
  misc_feature 1..9879: note = derived and/or modified CDS sequence (opt2) from DENV-1__FJ410188__SS-prME
  source 1..9879: mol_type = other RNA
tccgtcaccatgctcctcatgctcctccccaccgtcctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagcacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcatgttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgcctccggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgctccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcatcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatgctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccaggtcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagaagttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgagtggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10860 - RNA, 9879 nt, synthetic construct
  misc_feature 1..9879: note = derived and/or modified CDS sequence (opt2) from DENV-1__FJ478458__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgcctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggaggaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10861 - RNA, 9879 nt, synthetic construct
  misc_feature 1..9879: note = derived and/or modified CDS sequence (opt2) from DENV-1__FJ410190__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgaggagaagatcgtcggcctctacggcaacggcgtcgtcaccacctccggcacctacgtctccgccatcgcccaggccaagacctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccagcagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10862 - RNA, 9879 nt, synthetic construct
  misc_feature 1..9879: note = derived and/or modified CDS sequence (opt2) from DENV-1__EU482591__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10863 - RNA, 9879 nt, synthetic construct
  misc_feature 1..9879: note = derived and/or modified CDS sequence (opt2) from DENV-1__EU482592__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggactccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccgcccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcaccgctactcctggaagtcctggggcaaggccaagatcatcggcgccgacatccagaactccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggcgcaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggaggaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagacccgcaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccagcaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggtactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcaactggctcgagaagcacggcaccgagcgcctcaagcgcatggccatctccggcgacgactgcgtcgtcaagcccgtcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10864 - RNA, 9879 nt, synthetic construct
  misc_feature 1..9879: note = derived and/or modified CDS sequence (opt2) from DENV-1__EU482609__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggcccgcgcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10865 - RNA, 9879 nt, synthetic construct
  misc_feature 1..9879: note = derived and/or modified CDS sequence (opt2) from DENV-1__EU482610__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggtcctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10866 - RNA, 9879 nt, synthetic construct
  misc_feature 1..9879: note = derived and/or modified CDS sequence (opt2) from DENV-1__EU482611__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10867 - RNA, 9879 nt, synthetic construct
  misc_feature 1..9879: note = derived and/or modified CDS sequence (opt2) from DENV-1__FJ639735__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcgtcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10868 - RNA, 9879 nt, synthetic construct
  misc_feature 1..9879: note = derived and/or modified CDS sequence (opt2) from DENV-1__FJ639740__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcgccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggaggccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10869 - RNA, 9879 nt, synthetic construct
  misc_feature 1..9879: note = derived and/or modified CDS sequence (opt2) from DENV-1__FJ639741__SS-prME
  source 1..9879: mol_type = other RNA
tccgtcaccatcctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcacctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgccaaggcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggcctcggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctggaacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10870 - RNA, 9879 nt, synthetic construct
  misc_feature 1..9879: note = derived and/or modified CDS sequence (opt2) from DENV-1__FJ639743__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatggccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtccgctacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaaggtcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcgtcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggccgcaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgtcccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggaggccaacctcgacatcatcggccagcgcatcgagaacatccgcaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10871 - RNA, 9879 nt, synthetic construct
  misc_feature 1..9879: note = derived and/or modified CDS sequence (opt2) from DENV-1__FJ639794__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgtcgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaacctcggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggtccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcgtcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10872 - RNA, 9879 nt, synthetic construct
  misc_feature 1..9879: note = derived and/or modified CDS sequence (opt2) from DENV-1__FJ639796__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10873 - RNA, 9879 nt, synthetic construct
  misc_feature 1..9879: note = derived and/or modified CDS sequence (opt2) from DENV-1__FJ639797__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10874 - RNA, 9879 nt, synthetic construct
  misc_feature 1..9879: note = derived and/or modified CDS sequence (opt2) from DENV-1__FJ639802__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtaccgcttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10875 - RNA, 9879 nt, synthetic construct
  misc_feature 1..9879: note = derived and/or modified CDS sequence (opt2) from DENV-1__JN819410__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggcaacctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10876 - RNA, 9879 nt, synthetic construct
  misc_feature 1..9879: note = derived and/or modified CDS sequence (opt2) from DENV-1__FJ639806__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcaagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10877 - RNA, 9879 nt, synthetic construct
  misc_feature 1..9879: note = derived and/or modified CDS sequence (opt2) from DENV-1__JN819411__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcgtcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccgtccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagctcacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10878 - RNA, 9879 nt, synthetic construct
  misc_feature 1..9879: note = derived and/or modified CDS sequence (opt2) from DENV-1__FJ639812__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatgatgctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctcctcctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10879 - RNA, 9879 nt, synthetic construct
  misc_feature 1..9879: note = derived and/or modified CDS sequence (opt2) from DENV-1__FJ639813__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcatgaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccttctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatgcccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaactccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10880 - RNA, 9879 nt, synthetic construct
  misc_feature 1..9879: note = derived and/or modified CDS sequence (opt2) from DENV-1__JN819412__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctcctcctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10881 - RNA, 9879 nt, synthetic construct
  misc_feature 1..9879: note = derived and/or modified CDS sequence (opt2) from DENV-1__FJ810415__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcgtcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctcaactggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10882 - RNA, 9879 nt, synthetic construct
  misc_feature 1..9879: note = derived and/or modified CDS sequence (opt2) from DENV-1__FJ639814__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10883 - RNA, 9879 nt, synthetic construct
  misc_feature 1..9879: note = derived and/or modified CDS sequence (opt2) from DENV-1__FJ639815__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatgctcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10884 - RNA, 9879 nt, synthetic construct
  misc_feature 1..9879: note = derived and/or modified CDS sequence (opt2) from DENV-1__FJ639818__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggagaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacccacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10885 - RNA, 9879 nt, synthetic construct
  misc_feature 1..9879: note = derived and/or modified CDS sequence (opt2) from DENV-1__FJ639819__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgacaacttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctgcgtcaagaaggacctcatctcctacggcggcggctggcgcttccagggcctctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10886 - RNA, 9879 nt, synthetic construct
  misc_feature 1..9879: note = derived and/or modified CDS sequence (opt2) from DENV-1__FJ639820__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgccatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10887 - RNA, 9879 nt, synthetic construct
  misc_feature 1..9879: note = derived and/or modified CDS sequence (opt2) from DENV-1__FJ639821__SS-prME
  source 1..9879: mol_type = other RNA
tccgccaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtccgctacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctactacacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgacaacttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacggcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgacaaggccgccgaggtctcctgggagcaggaggccgagcactccggcgcctcccacaacatctccgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctgcgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgtcaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaaccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcaccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10888 - RNA, 9879 nt, synthetic construct
  misc_feature 1..9879: note = derived and/or modified CDS sequence (opt2) from DENV-1__FJ639824__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcgtcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10889 - RNA, 9879 nt, synthetic construct
  misc_feature 1..9879: note = derived and/or modified CDS sequence (opt2) from DENV-1__JN819425__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgtcaagatctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10890 - RNA, 9879 nt, synthetic construct
  misc_feature 1..9879: note = derived and/or modified CDS sequence (opt2) from DENV-1__FJ850099__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctctcctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10891 - RNA, 9879 nt, synthetic construct
  misc_feature 1..9879: note = derived and/or modified CDS sequence (opt2) from DENV-1__FJ850100__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacccacctcgccctcatggccaccttcaagatgcgccccatgttcgccgtcggcctcctcttccgccgcctcacctcccgcgaggtcctcctcctcaccatcggcctctccctcatggcctccatggagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatgatcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccaccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10892 - RNA, 9879 nt, synthetic construct
  misc_feature 1..9879: note = derived and/or modified CDS sequence (opt2) from DENV-1__FJ882579__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctcctcctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10893 - RNA, 9879 nt, synthetic construct
  misc_feature 1..9879: note = derived and/or modified CDS sequence (opt2) from DENV-1__JN819414__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcctacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctcctcctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccaccggcggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaacaccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10894 - RNA, 9879 nt, synthetic construct
  misc_feature 1..9879: note = derived and/or modified CDS sequence (opt2) from DENV-1__FJ873810__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10895 - RNA, 9879 nt, synthetic construct
  misc_feature 1..9879: note = derived and/or modified CDS sequence (opt2) from DENV-1__FJ850103__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgagtccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10896 - RNA, 9879 nt, synthetic construct
  misc_feature 1..9879: note = derived and/or modified CDS sequence (opt2) from DENV-1__FJ850104__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgtcaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaaccaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggaggccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10897 - RNA, 9879 nt, synthetic construct
  misc_feature 1..9879: note = derived and/or modified CDS sequence (opt2) from DENV-1__JN819405__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacccacctcgccctcatggccaccttcaagatgcgccccatgttcgccgtcggcctcctcttccgccgcctcacctcccgcgaggtcctcctcctcaccatcggcctctccctcatggcctccatggagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatgatcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagaccaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaacttcaccgaggtcaagggctacacctccggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10898 - RNA, 9879 nt, synthetic construct
  misc_feature 1..9879: note = derived and/or modified CDS sequence (opt2) from DENV-1__GQ199877__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctcccctcctccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10899 - RNA, 9879 nt, synthetic construct
  misc_feature 1..9879: note = derived and/or modified CDS sequence (opt2) from DENV-1__GU056029__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgtccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccgccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10900 - RNA, 9879 nt, synthetic construct
  misc_feature 1..9879: note = derived and/or modified CDS sequence (opt2) from DENV-1__GU056030__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtccgctacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctactacacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgacaacttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacggcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgacaaggccgccgaggtctcctgggagcaggaggccgagcactccggcgcctcccacaacatctccgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctgcgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgtcaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaaccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcaccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10901 - RNA, 9879 nt, synthetic construct
  misc_feature 1..9879: note = derived and/or modified CDS sequence (opt2) from DENV-1__GU056031__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagccctccaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgaccccgagggcgccctctggtga

SEQ ID NO: 10902 - RNA, 9879 nt, synthetic construct
  misc_feature 1..9879: note = derived and/or modified CDS sequence (opt2) from DENV-1__GU056032__SS-prME
  source 1..9879: mol_type = other RNA
tccgtcgccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatgctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaagatccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgacaccgagggcgccctctggtga

SEQ ID NO: 10903 - RNA, 9879 nt, synthetic construct
  misc_feature 1..9879: note = derived and/or modified CDS sequence (opt2) from DENV-1__GU056033__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgccaaggcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatctcccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagtcccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagaccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggcctcggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctggaacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10904 - RNA, 9879 nt, synthetic construct
  misc_feature 1..9879: note = derived and/or modified CDS sequence (opt2) from DENV-1__GU131833__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccagaacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatcaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatggcctccatgaagcgcttcaagaacgagtccgaccccgagggcgccctctggtga

SEQ ID NO: 10905 - RNA, 9879 nt, synthetic construct
  misc_feature 1..9879: note = derived and/or modified CDS sequence (opt2) from DENV-1__GU131834__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaagaccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcttcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10906 - RNA, 9879 nt, synthetic construct
  misc_feature 1..9879: note = derived and/or modified CDS sequence (opt2) from DENV-1__GU131835__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggtcctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgccgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatgaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcatgctcttcttcctctccggcaagggcctcggcaagacctccatcggcctcctctgcgtcaccgcctcctccgccctcctctggatggcctccgtcgagccccactggatcgccgcctccatcgtcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgcccaccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctcccgcatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccacctccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgacctcgagggcgccctctggtga

SEQ ID NO: 10907 - RNA, 9879 nt, synthetic construct
  misc_feature 1..9879: note = derived and/or modified CDS sequence (opt2) from DENV-1__GU131836__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgtccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctctcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtccccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccggccacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10908 - RNA, 9879 nt, synthetic construct
  misc_feature 1..9879: note = derived and/or modified CDS sequence (opt2) from DENV-1__GU131837__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggaggccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10909 - RNA, 9879 nt, synthetic construct
  misc_feature 1..9879: note = derived and/or modified CDS sequence (opt2) from DENV-1__JN819415__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10910 - RNA, 9879 nt, synthetic construct
  misc_feature 1..9879: note = derived and/or modified CDS sequence (opt2) from DENV-1__GU131838__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaagaccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga
